United States Patent 7,745,391 (HUMAN THROMBOSPONDIN POLYPEPTIDE) - sequence listing, part 260

SEQ ID NO: 735324 - DNA, 188297 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggctatcagcacccctactagttctaaccacatgactcctcccccttatactaatagctagccaatcccacctatcaaaagaaaccacaacccgaaaaaaactatatattaccatactaatcctactacaactattcctaattataaccttcaccgccacc

SEQ ID NO: 735325 - DNA, 188176 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggattatattatctgaagctccccttttgggcggaatgtg

SEQ ID NO: 735326 - DNA, 188219 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggcctgccatagaaaatgcaaccacagaaataaaatggattgctttttttccctgtagtgaaaatacatttaaatctatctca

SEQ ID NO: 735327 - DNA, 188321 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatggagtataaaccgaacagggtcttgggaagggacagtgtctaagtgtctgggtgccatccagagcatttggcaggggcagctgcaggatgagtgtgttcccaggggagtgagagcagcagctatatggcacttgtttgctactgccctctttttttctttttgccaaacctgaggtgactagtgtcacaggtggagcccatctcaca

SEQ ID NO: 735328 - DNA, 188005 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgtttgaagggtacttgcgggggccacaggttggggagggccctggttggggggctttctggcccgttgttcccccttttccagggtctggcccccctttggacctggtttttcccccgttgtcccttttcttaa

SEQ ID NO: 735329 - DNA, 187842 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaatccataaccagcaatactatggggcctgctagttctagatcgcgagcggccgct

SEQ ID NO: 735330 - DNA, 187746 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatagtccccactacccacatgcatgcacccataa

SEQ ID NO: 735331 - DNA, 188304 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggggtggccaagctgctgtgggccgccgccgtgcagaaccgctggaactcacgcttggggcgacggctacagttggattttgcccctgcaggcaggttcggtgtcgatactggcgttgatagcgctgctgccgtttgacgtggcgaatatgggcttgtttctcggcctgatcgccgtgttgtcgtagttcgcagccacccagga

SEQ ID NO: 735332 - DNA, 188261 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggctatcagcacccctactagttctaaccacatgactcctcccccttatactaatagctagccaatcccacctatcaaaagaaaccacaacccgaaaaaaactatatattaccatactaatcctactacaactattcctaattataaccttcaccgccacc

SEQ ID NO: 735333 - DNA, 188140 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggattatattatctgaagctccccttttgggcggaatgtg

SEQ ID NO: 735334 - DNA, 188183 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggcctgccatagaaaatgcaaccacagaaataaaatggattgctttttttccctgtagtgaaaatacatttaaatctatctca

SEQ ID NO: 735335 - DNA, 188285 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatggagtataaaccgaacagggtcttgggaagggacagtgtctaagtgtctgggtgccatccagagcatttggcaggggcagctgcaggatgagtgtgttcccaggggagtgagagcagcagctatatggcacttgtttgctactgccctctttttttctttttgccaaacctgaggtgactagtgtcacaggtggagcccatctcaca

SEQ ID NO: 735336 - DNA, 188177 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggggtggccaagctgctgtgggccgccgccgtgcagaaccgctggaactcacgcttggggcgacggctacagttggattttgcccctgcaggcaggttcggtgtcgatactggcgttgatagcgctgctgccgtttgacgtggcgaatatgggcttgtttctcggcctgatcgccgtgttgtcgtagttcgcagccacccagga

SEQ ID NO: 735337 - DNA, 188134 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggctatcagcacccctactagttctaaccacatgactcctcccccttatactaatagctagccaatcccacctatcaaaagaaaccacaacccgaaaaaaactatatattaccatactaatcctactacaactattcctaattataaccttcaccgccacc

SEQ ID NO: 735338 - DNA, 188013 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggattatattatctgaagctccccttttgggcggaatgtg

SEQ ID NO: 735339 - DNA, 188056 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggcctgccatagaaaatgcaaccacagaaataaaatggattgctttttttccctgtagtgaaaatacatttaaatctatctca
